United States Patent 11,760,981 (ENGINEERED GLYCOSYLTRANSFERASES AND STEVIOL GLYCOSIDE GLUCOSYLATION METHODS) - sequence listing, part 2

SEQ ID NO: 2085 - DNA, 2379 bp, Artificial Sequence
  Variant of sucrose synthase
atgattgaagtactgcgccaacagctgctggatagcccgcgttcatggcgtgcattcctgcgtactttagtcgcatctcagcgtgactcatggttacatgaggatttacagcgtgcgtgcaagacgtttcgtgaacagtcgccggaaggccatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtggacggagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgacggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2086 - protein, 793 aa, Artificial Sequence
  Variant of sucrose synthase
MIEVLRQQLLDSPRSWRAFLRTLVASQRDSWLHEDLQRACKTFREQSPEGHPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWTEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2087 - DNA, 2379 bp, Artificial Sequence
  Variant of sucrose synthase
atgattgaagaactgcgccaacagctgctggatagcccgcgttcatggcgtgcattcctgcgtctgttagtcgcatctcagcgtgactcatggttacatgaggatttacagcgtgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2088 - protein, 793 aa, Artificial Sequence
  Variant of sucrose synthase
MIEELRQQLLDSPRSWRAFLRLLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2089 - DNA, 2379 bp, Artificial Sequence
  Variant of sucrose synthase
atgattgaagaactgcgccaacagctgctggatagcccgcgttcatggcgtgcattcctgcgtactttagtcgcatctcagcgtgactcatggttacatgaggatttacaggtggcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgacggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2090 - protein, 793 aa, Artificial Sequence
  Variant of sucrose synthase
MIEELRQQLLDSPRSWRAFLRTLVASQRDSWLHEDLQVACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2091 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2092 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2093 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatccccagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2094 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDPQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2095 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagtgcgcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2096 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSARLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2097 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcggtggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2098 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSVARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2099 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgttgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggacaagtaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccattgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2100 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDKYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2101 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2102 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPSTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2103 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatccccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2104 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDPQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2105 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagccaggcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2106 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISQAALARVSERYTWERYAERLMTIARCFGFWRFVLSRESQVMERYLQMFRHLQWRPLAHAVPME

SEQ ID NO: 2107 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggcctatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2108 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPAYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2109 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcaccgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2110 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISTAALARVSERYTWERYAERLMTIARCFGFWRFVLSRESQVMERYLQMFRHLQWRPLAHAVPME

SEQ ID NO: 2111 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgacgctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2112 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGDAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2113 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2114 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPLYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2115 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtcacgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2116 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARHEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2117 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaacagcgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2118 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEQRFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2119 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcaggccagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2120 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQASMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2121 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcatggcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2122 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISMAALARVSERYTWERYAERLMTIARCFGFWRFVLSRESQVMERYLQMFRHLQWRPLAHAVPME

SEQ ID NO: 2123 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgccgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2124 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISAAALARVSERYTWERYAERLMTIARCFGFWRFVLSRESQVMERYLQMFRHLQWRPLAHAVPME

SEQ ID NO: 2125 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgcggcaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2126 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRGKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2127 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacagacgatggaacgctatctgcaaatgttccgccacctgcaatggcgcccgctggctcatgccgtaccgatggag

SEQ ID NO: 2128 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQTMERYLQMFRHLQWRPLAHAVPME

SEQ ID NO: 2129 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagaacgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2130 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLENVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2131 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccagtaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2132 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDQYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2133 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtgtggaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2134 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARVEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2135 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactcaggaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2136 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTQERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2137 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccatcctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2138 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATILSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2139 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggacgcgtaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2140 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDAYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2141 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgccgaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2142 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTAERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2143 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccacgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2144 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGHEPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2145 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggacaggtaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2146 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2147 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2148 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2149 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2150 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2151 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2152 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2153 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccagacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2154 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2155 - DNA, 2379 bp, Artificial Sequence
  Variant of sucrose synthase
atgattgaagaactgcgccaacagctgctggatagcccgcgttcatggcgtgcattcctgcgtctgttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcggagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2156 - protein, 793 aa, Artificial Sequence
  Variant of sucrose synthase
MIEELRQQLLDSPRSWRAFLRLLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2157 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatgaggatttacagcgtgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggattatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2158 - protein, 793 aa, Artificial Sequence
  Variant of sucrose synthase
MIEELRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2159 - DNA, 2379 bp, Artificial Sequence
  Variant of sucrose synthase
atgattgaagaactgcgccaacagctgctggatagcccgcgttcatggcgtgcattcctgcgtactttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2160 - protein, 793 aa, Artificial Sequence
  Variant of sucrose synthase
MIEELRQQLLDSPRSWRAFLRTLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2161 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaggatttacagcgcgcgtgcaagacgtttcgtgaacagcctccggaaggctatcctgaagatattggttggctggcagattttatcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagttcgcgcttacgtagcctggccaatttggtgatcatcggtggtcatgttgatgtgcagaatagtatggatgcagaagaacgcgaagaaatccgtcgtatgcacgagatcatggacaagtaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2162 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDPQKPIILSMARMDRIKNLSGLAELYGRSSRLRSLANLVIIGGHVDVQNSMDAEEREEIRRMHEIMDKYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2163 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaggatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgtacgtattttagctatgcccgtaccgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacagaacagtatggatgcagaagaacgcgaagaaatccgtcgtatgcacgagatcatggacaagtaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2164 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSARLRSLANLVIIGGHVDVQNSMDAEEREEIRRMHEIMDKYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME

SEQ ID NO: 2165 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgtcagaaaccgattattctgtcgatggcccgtatggatcgcatcaagaacctgagcggtctggccgaactgtatggtcggagtgcgcgcttacgtagcctggccaatttggtgatcatcggtggtcatgttgatccacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2166 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSARLRSLANLVIIGGHVDPQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME

SEQ ID NO: 2167 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagcccgggcgcagatccgagtacgtattttagctatgcccgtaccgaagaacgcttctcgtcgctgtggccagaaatcgaaagtctgctgtttggccgcgaaccaggtccggatattcgtggtgttctcgaagatcctcagaaaccgattattctgtcggtggcccgtatggatcgcatcaagaacctgagcggtctggccgaactgtatggtcggagtgcgcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2168 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARTEERFSSLWPEIESLLFGREPGPDIRGVLEDPQKPIILSVARMDRIKNLSGLAELYGRSARLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2169 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcggtggcccgtatggatcgcatcaagaacctgagcggtctggccgaactgtatggtcggagttctcgcttacgtagcctggccaatttggtgatcatcggtggtcatgttgatccacaggccagtatggatgcagaagaacgcgaagaaatccgtcgtatgcacgagatcatggacaagtaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2170 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSVARMDRIKNLSGLAELYGRSSRLRSLANLVIIGGHVDPQASMDAEEREEIRRMHEIMDKYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2171 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccatcctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtaccgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagttcgcgcttacgtagcctggccaatttggtgatcatcggtggtcatgttgatgtacagaacagtatggatgcagaagaacgcgaagaaatccgtcgtatgcacgagatcatggacaagtaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2172 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATILSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARTEERFSSLWPEIESLLFGREPGPDIRGVLEDPQKPIILSMARMDRIKNLSGLAELYGRSSRLRSLANLVIIGGHVDVQNSMDAEEREEIRRMHEIMDKYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2173 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaggatttacagcgcgcgtgcaagacgtttcgtgaacagcctccggaaggctatcctgaagatattggttggctggcagattttatcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttcgcgcttacgtagcctggccaatttggtgatcatcggtggtcatgttgatgtgcagaatagtatggatgcagaagaacgcgaagaaatccgtcgtatgcacgagatcatggacaagtaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2174 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDKYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISQAALARVSERYTWERYAERLMTIARCFGFWRFVLSRESQVMERYLQMFRHLQWRPLAHAVPME

SEQ ID NO: 2175 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaggatttacagcgcgcgtgcaagacgtttcgtgaacagcctccggaaggctatcctgaagatattggttggctggcagattttatcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccatcctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgtacgtattttagctatgcccgtaccgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagttctcgcttacgtagcctggccaatttggtgatcatcggtggtcatgttgatccacaggccagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2176 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATILSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDPQKPIILSMARMDRIKNLSGLAELYGRSSRLRSLANLVIIGGHVDPQASMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2177 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttatcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgatgctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccatatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgtacgtattttagctatgcccgtaccgaagaacgcttctcgtcgctgtggccagaaatcgaaagtctgctgtttggccgcgaaccaggtccggatattcgtggtgttctcgaagatcgtcagaaaccgattattctgtcggtggcccgtatggatcgcatcaagaacctgagcggtctggccgaactgtatggtcggagtgcgcgcttacgtagcctggccaatttggtgatcatcggtggtcatgttgatgtacagaacagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2178 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFIAHTQEAIFRDPWMVFAWRLRPGVWEYVRIHVEQLAVEELSTDEYLQAKEQLVGLGAEGDAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSVARMDRIKNLSGLAELYGRSARLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2179 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaggatttacagcgcgcgtgcaagacgtttcgtgaacagcctccggaaggctatcctgaagatattggttggctggcagattttatcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtaccgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggacaagtaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2180 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPSTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDKYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2181 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2182 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2183 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccatcctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttcgcgcttacgtagcctggccaatttggtgatcatcggtggtcatgttgatgtacaggccagtatggatgcagaagaacgcgaagaaatccgtcgtatgcacgagatcatggacaagtaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2184 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATILSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQASMDAEEREEIRRMHEIMDKYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME

SEQ ID NO: 2185 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaggatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcgtcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2186 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDRQKPIILSMARMDRIKNLSGLAELYGRSARLRSLANLVIIGGHVDVQASMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISQAALARVSERYTWERYAERLMTIARCFGFWRFVLSRESQVMERYLQMFRHLQWRPLAHAVPME

SEQ ID NO: 2187 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttatcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgtacgtattttagctatgcccgtaccgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttcgcgcttacgtagcctggccaatttggtgatcatcggtggtcatgttgatgtgcagaatagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacagactatggaacgctatctgcaaatgttccgccacctgcaatggcgcccgctggctcatgccgtaccgatggag

SEQ ID NO: 2188 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQTMERYLQMFRHLQWRPLAHAVPME

SEQ ID NO: 2189 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgatgctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttcgcgcttacgtagcctggccaatttggtgatcatcggtggtcatgttgatgtacaggccagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacagactatggaacgctatctgcaaatgttccgccacctgcaatggcgcccgctggctcatgccgtaccgatggag

SEQ ID NO: 2190 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGDAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQASMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQTMERYLQMFRHLQWRPLAHAVPME

SEQ ID NO: 2191 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaggatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgtacgtattttagctatgcccgtcatgaagaacgcttctcgtcgctgtggccagaaatcgaaagtctgctgtttggccgcgaaccaggtccggatattcgtggtgttctcgaagatcgccagaaaccgattattctgtcggtggcccgtatggatcgcatcaagaacctgagcggtctggccgaactgtatggtcggagttcgcgcttacgtagcctggccaatttggtgatcatcggtggtcatgttgatgtacagaacagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacagactatggaacgctatctgcaaatgttccgccacctgcaatggcgcccgctggctcatgccgtaccgatggag

SEQ ID NO: 2192 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPRTYFSYARHEERFSSLWPEIESLLFGREPGPDIRGVLEDRQKPIILSVARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQTMERYLQMFRHLQWRPLAHAVPME

SEQ ID NO: 2193 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2194 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDRQKPIILSMARMDRIKNLSGLAELYGRSSRLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2195 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttatcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccatcctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgtacgtattttagctatgcccgtcatgaagaacgcttctcgtcgctgtggccagaaatcgaaagtctgctgtttggccgcgaaccaggtccggatattcgtggtgttctcgaagatcgtcagaaaccgattattctgtcggtggcccgtatggatcgcatcaagaacctgagcggtctggccgaactgtatggtcggagttcgcgcttacgtagcctggccaatttggtgatcatcggtggtcatgttgatgtacaggccagtatggatgcagaagaacgcgaagaaatccgtcgtatgcacgagatcatggacaagtaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2196 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATILSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARHEERFSSLWPEIESLLFGREPGPDIRGVLEDRQKPIILSVARMDRIKNLSGLAELYGRSSRLRSLANLVIIGGHVDVQASMDAEEREEIRRMHEIMDKYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2197 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagttctcgcttacgtagcctggccaatttggtgatcatcggtggtcatgttgatgtacaggccagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2198 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDPQKPIILSMARMDRIKNLSGLAELYGRSSRLRSLANLVIIGGHVDVQASMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2199 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgatgctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttcgcgcttacgtagcctggccaatttggtgatcatcggtggtcatgttgatccacaggccagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2200 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGDAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDRQKPIILSMARMDRIKNLSGLAELYGRSSRLRSLANLVIIGGHVDPQASMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2201 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccatcctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtacaggccagtatggatgcagaagaacgcgaagaaatccgtcgtatgcacgagatcatggacaagtaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2202 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATILSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDRQKPIILSMARMDRIKNLSGLAELYGRSSRLRSLANLVIIGGHVDVQASMDAEEREEIRRMHEIMDKYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISQAALARVSERYTWERYAERLMTIARCFGFWRFVLSRESQVMERYLQMFRHLQWRPLAHAVPME

SEQ ID NO: 2203 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaggatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtaccgaagaacgcttctcgtcgctgtggccagaaatcgaaagtctgctgtttggccacgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatccacagaacagtatggatgcagaagaacgcgaagaaatccgtcgtatgcacgagatcatggacaagtaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2204 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGHEPGPDIRGVLEDPQKPIILSMARMDRIKNLSGLAELYGRSARLRSLANLVIIGGHVDPQNSMDAEEREEIRRMHEIMDKYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2205 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccatcctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgtacgtattttagctatgcccgtaccgaagaacgcttctcgtcgctgtggccagaaatcgaaagtctgctgtttggccgcgaaccaggtccggatattcgtggtgttctcgaagatcgtcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtgcagaatagtatggatgcagaagaacgcgaagaaatccgtcgtatgcacgagatcatggacaagtaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2206 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATILSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSARLRSLANLVIIGGHVDVQNSMDAEEREEIRRMHEIMDKYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2207 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttatcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgatgctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccatcctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtaccgaagaacgcttctcgtcgctgtggccagaaatcgaaagtctgctgtttggccacgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggacaagtaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2208 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFIAHTQEAIFRDPWMVFAWRLRPGVWEYVRIHVEQLAVEELSTDEYLQAKEQLVGLGAEGDAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATILSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARTEERFSSLWPEIESLLFGHEPGPDIRGVLEDPQKPIILSMARMDRIKNLSGLAELYGRSARLRSLANLVIIGGHVDVQASMDAEEREEIRRMHEIMDKYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2209 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttatcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgatgctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtacagaacagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacagactatggaacgctatctgcaaatgttccgccacctgcaatggcgcccgctggctcatgccgtaccgatggag

SEQ ID NO: 2210 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFIAHTQEAIFRDPWMVFAWRLRPGVWEYVRIHVEQLAVEELSTDEYLQAKEQLVGLGAEGDAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDRQKPIILSMARMDRIKNLSGLAELYGRSSRLRSLANLVIIGGHVDVQNSMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQTMERYLQMFRHLQWRPLAHAVPME

SEQ ID NO: 2211 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttatcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccatcctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtaccgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagtgcgcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2212 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATILSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSARLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISQAALARVSERYTWERYAERLMTIARCFGFWRFVLSRESQVMERYLQMFRHLQWRPLAHAVPME

SEQ ID NO: 2213 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaggatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgatgctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgtacgtattttagctatgcccgtcatgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttcgcgcttacgtagcctggccaatttggtgatcatcggtggtcatgttgatgtacaggccagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2214 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGDAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARHEERFSSLWPEIESLLFGREPGPDIRGVLEDRQKPIILSMARMDRIKNLSGLAELYGRSSRLRSLANLVIIGGHVDVQASMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISQAALARVSERYTWERYAERLMTIARCFGFWRFVLSRESQVMERYLQMFRHLQWRPLAHAVPME

SEQ ID NO: 2215 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccatcctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgtacgtattttagctatgcccgtaccgaagaacgcttctcgtcgctgtggccagaaatcgaaagtctgctgtttggccgcgaaccaggtccggatattcgtggtgttctcgaagatcgccagaaaccgattattctgtcggtggcccgtatggatcgcatcaagaacctgagcggtctggccgaactgtatggtcggagttctcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2216 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATILSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSVARMDRIKNLSGLAELYGRSSRLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2217 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtaccgaagaacgcttctcgtcgctgtggccagaaatcgaaagtctgctgtttggccgcgaaccaggtccggatattcgtggtgttctcgaagatcgtcagaaaccgattattctgtcggtggcccgtatggatcgcatcaagaacctgagcggtctggccgaactgtatggtcggagttctcgcttacgtagcctggccaatttggtgatcatcggtggtcatgttgatgtacagaacagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacagactatggaacgctatctgcaaatgttccgccacctgcaatggcgcccgctggctcatgccgtaccgatggag

SEQ ID NO: 2218 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARTEERFSSLWPEIESLLFGREPGPDIRGVLEDRQKPIILSVARMDRIKNLSGLAELYGRSSRLRSLANLVIIGGHVDVQNSMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISQAALARVSERYTWERYAERLMTIARCFGFWRFVLSRESQTMERYLQMFRHLQWRPLAHAVPME

SEQ ID NO: 2219 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaggatttacagcgcgcgtgcaagacgtttcgtgaacagcctccggaaggctatcctgaagatattggttggctggcagattttatcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccatcctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagttcgcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2220 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATILSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARHEERFSSLWPEIESLLFGREPGPDIRGVLEDPQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2221 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccatcctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgtcagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2222 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATILSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2223 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttatcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgatgctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtaccgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacagactatggaacgctatctgcaaatgttccgccacctgcaatggcgcccgctggctcatgccgtaccgatggag

SEQ ID NO: 2224 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFIAHTQEAIFRDPWMVFAWRLRPGVWEYVRIHVEQLAVEELSTDEYLQAKEQLVGLGAEGDAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPSTYFSYARTEERFSSLWPEIESLLFGREPGPDIRGVLEDPQKPIILSMARMDRIKNLSGLAELYGRSARLRSLANLVIIGGHVDVQASMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQTMERYLQMFRHLQWRPLAHAVPME

SEQ ID NO: 2225 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgatgctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcgtcagaaaccgattattctgtcgatggcccgtatggatcgcatcaagaacctgagcggtctggccgaactgtatggtcggagttctcgcttacgtagcctggccaatttggtgatcatcggtggtcatgttgatgtacagaacagtatggatgcagaagaacgcgaagaaatccgtcgtatgcacgagatcatggacaagtaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2226 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGDAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDRQKPIILSMARMDRIKNLSGLAELYGRSSRLRSLANLVIIGGHVDVQNSMDAEEREEIRRMHEIMDKYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2227 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttatcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtaccgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagttcgcgcttacgtagcctggccaatttggtgatcatcggtggtcatgttgatgtacaggccagtatggatgcagaagaacgcgaagaaatccgtcgtatgcacgagatcatggacaagtaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2228 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARTEERFSSLWPEIESLLFGREPGPDIRGVLEDPQKPIILSMARMDRIKNLSGLAELYGRSSRLRSLANLVIIGGHVDVQASMDAEEREEIRRMHEIMDKYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME

SEQ ID NO: 2229 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttatcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttcgcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacagactatggaacgctatctgcaaatgttccgccacctgcaatggcgcccgctggctcatgccgtaccgatggag

SEQ ID NO: 2230 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQTMERYLQMFRHLQWRPLAHAVPME

SEQ ID NO: 2231 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtaccgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagtgcgcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2232 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARTEERFSSLWPEIESLLFGREPGPDIRGVLEDRQKPIILSMARMDRIKNLSGLAELYGRSARLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2233 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgtacgtattttagctatgcccgtaccgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagttcgcgcttacgtagcctggccaatttggtgatcatcggtggtcatgttgatccacaggccagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2234 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDPQKPIILSMARMDRIKNLSGLAELYGRSSRLRSLANLVIIGGHVDPQASMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2235 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgtacgtattttagctatgcccgtaccgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagtgcgcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2236 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSARLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2237 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaggatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccatcctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtaccgaagaacgcttctcgtcgctgtggccagaaatcgaaagtctgctgtttggccacgaaccaggtccggatattcgtggtgttctcgaagatcctcagaaaccgattattctgtcggtggcccgtatggatcgcatcaagaacctgagcggtctggccgaactgtatggtcggagttcgcgcttacgtagcctggccaatttggtgatcatcggtggtcatgttgatgtacagaacagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2238 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATILSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARTEERFSSLWPEIESLLFGHEPGPDIRGVLEDPQKPIILSVARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME

SEQ ID NO: 2239 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttcgcgcttacgtagcctggccaatttggtgatcatcggtggtcatgttgatgtacagaacagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2240 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2241 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaggatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccatcctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtaccgaagaacgcttctcgtcgctgtggccagaaatcgaaagtctgctgtttggccgcgaaccaggtccggatattcgtggtgttctcgaagatcgtcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacagactatggaacgctatctgcaaatgttccgccacctgcaatggcgcccgctggctcatgccgtaccgatggag

SEQ ID NO: 2242 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATILSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARTEERFSSLWPEIESLLFGREPGPDIRGVLEDRQKPIILSMARMDRIKNLSGLAELYGRSARLRSLANLVIIGGHVDVQASMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQTMERYLQMFRHLQWRPLAHAVPME

SEQ ID NO: 2243 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgatgctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgtacgtattttagctatgcccgtaccgaagaacgcttctcgtcgctgtggccagaaatcgaaagtctgctgtttggccacgaaccaggtccggatattcgtggtgttctcgaagatcgtcagaaaccgattattctgtcgatggcccgtatggatcgcatcaagaacctgagcggtctggccgaactgtatggtcggagttcgcgcttacgtagcctggccaatttggtgatcatcggtggtcatgttgatgtacaggccagtatggatgcagaagaacgcgaagaaatccgtcgtatgcacgagatcatggacaagtaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2244 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGDAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGHEPGPDIRGVLEDRQKPIILSMARMDRIKNLSGLAELYGRSSRLRSLANLVIIGGHVDVQASMDAEEREEIRRMHEIMDKYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2245 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttatcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgatgctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccgcaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtaccgaagaacgcttctcgtcgctgtggccagaaatcgaaagtctgctgtttggccgcgaaccaggtccggatattcgtggtgttctcgaagatcctcagaaaccgattattctgtcggtggcccgtatggatcgcatcaagaacctgagcggtctggccgaactgtatggtcggagttctcgcttacgtagcctggccaatttggtgatcatcggtggtcatgttgatgtacagaacagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2246 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFIAHTQEAIFRDPWMVFAWRLRPGVWEYVRIHVEQLAVEELSTDEYLQAKEQLVGLGAEGDAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPQSDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPSTYFSYARTEERFSSLWPEIESLLFGREPGPDIRGVLEDPQKPIILSVARMDRIKNLSGLAELYGRSSRLRSLANLVIIGGHVDVQNSMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2247 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgatgctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcggtggcccgtatggatcgcatcaagaacctgagcggtctggccgaactgtatggtcggagttctcgcttacgtagcctggccaatttggtgatcatcggtggtcatgttgatgtacagaacagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2248 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGDAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPRTYFSYARHEERFSSLWPEIESLLFGREPGPDIRGVLEDPQKPIILSVARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2249 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgtacgtattttagctatgcccgtaccgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2250 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME

SEQ ID NO: 2251 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaggatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgtacgtattttagctatgcccgtcatgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagtgcgcgcttacgtagcctggccaatttggtgatcatcggtggtcatgttgatgtgcagaatagtatggatgcagaagaacgcgaagaaatccgtcgtatgcacgagatcatggacaagtaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2252 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARHEERFSSLWPEIESLLFGREPGPDIRGVLEDRQKPIILSMARMDRIKNLSGLAELYGRSARLRSLANLVIIGGHVDVQNSMDAEEREEIRRMHEIMDKYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2253 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgtacgtattttagctatgcccgtaccgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacagaacagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2254 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSARLRSLANLVIIGGHVDVQNSMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2255 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccatcctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcggtggcccgtatggatcgcatcaagaacctgagcggtctggccgaactgtatggtcggagttcgcgcttacgtagcctggccaatttggtgatcatcggtggtcatgttgatgtacagaacagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggttatggaacgctatctgcaaatgttccgccacctgcaatggcgcccgctggctcatgccgtaccgatggag

SEQ ID NO: 2256 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATILSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSVARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISQAALARVSERYTWERYAERLMTIARCFGFWRFVLSRESQVMERYLQMFRHLQWRPLAHAVPME

SEQ ID NO: 2257 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccatcctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtaccgaagaacgcttctcgtcgctgtggccagaaatcgaaagtctgctgtttggccgcgaaccaggtccggatattcgtggtgttctcgaagatcgtcagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccactaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2258 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATILSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2259 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtcatgaagaacgcttctcgtcgctgtggccagaaatcgaaagtctgctgtttggccgcgaaccaggtccggatattcgtggtgttctcgaagatcgtcagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2260 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPRTYFSYARHEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2261 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgtacgtattttagctatgcccgtcatgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttcgcgcttacgtagcctggccaatttggtgatcatcggtggtcatgttgatgtacaggccagtatggatgcagaagaacgcgaagaaatccgtcgtatgcacgagatcatggaccactaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2262 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARHEERFSSLWPEIESLLFGREPGPDIRGVLEDRQKPIILSMARMDRIKNLSGLAELYGRSSRLRSLANLVIIGGHVDVQASMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2263 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttatcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgtacgtattttagctatgcccgtaccgaagaacgcttctcgtcgctgtggccagaaatcgaaagtctgctgtttggccgcgaaccaggtccggatattcgtggtgttctcgaagatcgtcagaaaccgattattctgtcgatggcccgtatggatcgcatcaagaacctgagcggtctggccgaactgtatggtcggagtgcgcgcttacgtagcctggccaatttggtgatcatcggtggtcatgttgatccacaggccagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2264 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSARLRSLANLVIIGGHVDPQASMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2265 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtacaggccagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2266 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQASMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2267 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaggatttacagcgcgcgtgcaagacgtttcgtgaacagcctccggaaggctatcctgaagatattggttggctggcagattttatcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgatgctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccatcctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgtacgtattttagctatgcccgtaccgaagaacgcttctcgtcgctgtggccagaaatcgaaagtctgctgtttggccgcgaaccaggtccggatattcgtggtgttctcgaagatcctcagaaaccgattattctgtcggtggcccgtatggatcgcatcaagaacctgagcggtctggccgaactgtatggtcggagtgcgcgcttacgtagcctggccaatttggtgatcatcggtggtcatgttgatccacaggccagtatggatgcagaagaacgcgaagaaatccgtcgtatgcacgagatcatggaccactaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgactgcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2268 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFIAHTQEAIFRDPWMVFAWRLRPGVWEYVRIHVEQLAVEELSTDEYLQAKEQLVGLGAEGDAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATILSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDPQKPIILSVARMDRIKNLSGLAELYGRSARLRSLANLVIIGGHVDPQASMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISQAALARVSERYTWERYAERLMTIARCFGFWRFVLSRESQVMERYLQMFRHLQWRPLAHAVPME

SEQ ID NO: 2269 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaagctgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2270 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKAVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2271 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaatgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2272 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKNVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2273 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaacgggtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2274 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKRVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2275 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacattgtcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2276 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHCQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2277 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtgacgcatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2278 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVTHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2279 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtgggtcatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2280 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVGHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2281 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaagaggtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2282 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKEVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2283 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaacatgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2284 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKHVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2285 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattggtacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2286 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2287 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2288 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGGLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2289 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaatgggtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2290 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKWVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2291 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcactacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattcggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2292 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKFGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2293 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattctgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2294 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNILSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2295 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgatttctacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2296 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILISTRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2297 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctggtggtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2298 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLVVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2299 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtgagtcatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2300 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVSHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2301 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaagttgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2302 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKVVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2303 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattactacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2304 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILITTRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2305 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatcttcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2306 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHLQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2307 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcagttaccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2308 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSSYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2309 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaagatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattggcacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaagctgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgacgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2310 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKAVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2311 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaagatttacagcgcgcgtgcaagacgtttcgtgaacagcctccggaaggctatcctgaagatattggttggctggcagattttattgcgcatactcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2312 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2313 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgctacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2314 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGGLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2315 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaagatttacagcgcgcgtgcaagacgtttcgtgaacagcctccggaaggctatcctgaagatattggttggctggcagattttgttgcgcattgtcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2316 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVAHCQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2317 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaagatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgctacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaagctgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgacgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2318 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKAVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2319 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattggcacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaagctgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2320 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKAVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME

SEQ ID NO: 2321 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggctacatactgatttacagcacgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2322 - protein, 793 aa, Artificial Sequence
  Variant of sucrose synthase
MIEVLRQQLLDSPRSWRAFLRHLVASQRDSWLHTDLQHACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2323 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttatttcgcattgtcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgctacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcacgaagatcgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaagctgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2324 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFISHCQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEDRFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKAVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2325 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattggcacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtacggaagatcgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2326 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARTEDRFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2327 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgttacgcattgtcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2328 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVTHCQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGGLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME

SEQ ID NO: 2329 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgttacgcattgtcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattggcacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtacggaagatcgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaacgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2330 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVTHCQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGGLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARTEDRFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKNVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME

SEQ ID NO: 2331 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaagatttacagcgcgcgtgcaagacgtttcgtgaacagcctccggaaggctatcctgaagatattggttggctggcagattttgtttcgcatactcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgctacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcacgaagatcgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaacgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2332 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVSHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGGLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEDRFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKNVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME

SEQ ID NO: 2333 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtttcgcatactcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgctacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcacgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2334 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVSHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME

SEQ ID NO: 2335 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtttcgcattgtcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgctacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgacgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2336 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVSHCQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2337 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaagatttacagcgcgcgtgcaagacgtttcgtgaacagcctccggaaggctatcctgaagatattggttggctggcagattttgttgcgcattgtcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgctacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcacgaagatcgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2338 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVAHCQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEDRFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2339 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaagatttacagcgcgcgtgcaagacgtttcgtgaacagcctccggaaggctatcctgaagatattggttggctggcagattttgtttcgcatactcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattggcacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtacggaagatcgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgacgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2340 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVSHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARTEDRFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2341 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtttcgcatactcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcacgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgacgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2342 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVSHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGGLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2343 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2344 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME

SEQ ID NO: 2345 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtttcgcatactcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattggcacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaagctgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgacgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2346 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVSHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGGLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKAVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2347 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtttcgcatactcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgctacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtacggaagatcgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2348 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVSHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARTEDRFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME

SEQ ID NO: 2349 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaagatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattggcacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcacgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaagctgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgacgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2350 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGGLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKAVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2351 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaagatttacagcgcgcgtgcaagacgtttcgtgaacagcctccggaaggctatcctgaagatattggttggctggcagattttgttacgcattgtcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattggcacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcacgaagatcgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgacgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2352 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVTHCQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEDRFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2353 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgctacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtacggaagatcgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaagctgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2354 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARTEDRFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKAVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME

SEQ ID NO: 2355 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaagatttacagcgcgcgtgcaagacgtttcgtgaacagcctccggaaggctatcctgaagatattggttggctggcagattttattgcgcattgtcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcacgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2356 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFIAHCQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2357 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttatttcgcatactcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgctacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtacggaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2358 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFISHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARTEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME

SEQ ID NO: 2359 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattggcacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcacgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaacgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgacgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2360 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGGLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKNVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2361 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttattacgcatactcaggaagcgttcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattggcacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcacgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2362 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFITHTQEAFFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGGLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2363 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgttacgcatactcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgctacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaagctgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgacgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2364 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVTHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGGLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKAVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2365 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaagatttacagcgcgcgtgcaagacgtttcgtgaacagcctccggaaggctatcctgaagatattggttggctggcagattttgtttcgcattgtcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgctacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcacgaagatcgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggtcgacttcctggaagcagcgcgtgaacgtccgaagtattgggaggaaattagcgacgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2366 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVSHCQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGGLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEDRFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLVDFLEAARERPKYWEEISDAALARVSERYTWERYAERLMTIARCFGFWRFVLSRESQVMERYLQMFRHLQWRPLAHAVPME

SEQ ID NO: 2367 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttattgcgcatactcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattggcacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcacgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2368 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2369 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattggcacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcacgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2370 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGGLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME

SEQ ID NO: 2371 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaagatttacagcgcgcgtgcaagacgtttcgtgaacagcctccggaaggctatcctgaagatattggttggctggcagattttgttgcgcatactcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgctacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcacgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgacgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2372 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2373 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgttacgcattgtcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcacgaagatcgcttctcgtcgctgtggccagaaatcgaaagtctgctgtttggccgcgaaccaggtccggatatccgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaagctgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaagcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2374 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVTHCQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEDRFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKAVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME

SEQ ID NO: 2375 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaagatttacagcgcgcgtgcaagacgtttcgtgaacagcctccggaaggctatcctgaagatattggttggctggcagattttattgcgcatactcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattggcacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2376 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2377 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattggcacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtacggaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2378 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARTEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2379 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttattacgcatactcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2380 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFITHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2381 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaagatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgctacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgacgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2382 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2383 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgactactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2384 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELTTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2385 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgacgcttggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2386 - protein, 793 aa, Artificial Sequence
  Variant of sucrose synthase
MIEVLRQQLLDSPRSWRAFLRHLVASQRDAWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2387 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgagggccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2388 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLRAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2389 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgaccgttcacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2390 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATVHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2391 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccattccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2392 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTIPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2393 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaaatggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2394 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGRENGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2395 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctgacagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcggggcgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2396 - protein, 793 aa, Artificial Sequence
  Variant of sucrose synthase
MIEVLRQQLLDSPRSWRAFLRHLVASQRDSWLHTDLQRACKTFREQPPEGYPEDIGWLTDFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2397 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtgcgatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2398 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGAIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2399 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttactgcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2400 - protein, 793 aa, Artificial Sequence
  Variant of sucrose synthase
MIEVLRQQLLDSPRSWRAFLRHLVASQRDSWLHTDLLRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2401 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagcctctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcgcgcgaatcacaggtcatggaacgctatctgcaaatgttccgccacctgcaatggcgcccgctggctcatgccgtaccgatggag

SEQ ID NO: 2402 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQPLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2403 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtaagatctggactgatttagcagcaggtcgtagtgctattctggaatttctaggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2404 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGKIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2405 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtcatcgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2406 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRHRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2407 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttaggggcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2408 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLGAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2409 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggtttctaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2410 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVSTLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2411 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttaatgcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2412 - protein, 793 aa, Artificial Sequence
  Variant of sucrose synthase
MIEVLRQQLLDSPRSWRAFLRHLVASQRDSWLHTDLMRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2413 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcaagtaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2414 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVASKLADFLEAARERPKYWEEISDAALARVSERYTWERYAERLMTIARCFGFWRFVLSRESQVMERYLQMFRHLQWRPLAHAVPME

SEQ ID NO: 2415 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgctctcagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2416 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRSQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2417 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcatgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2418 - protein, 793 aa, Artificial Sequence
  Variant of sucrose synthase
MIEVLRQQLLDSPRSWRAFLRHLVASQHDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2419 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaatcttgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2420 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNLDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2421 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatccccagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgaccttgcacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2422 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATLHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2423 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgctcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2424 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRARETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2425 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttaactgcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2426 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLTAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2427 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttgtgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2428 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVVQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2429 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgacatgtggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2430 - protein, 793 aa, Artificial Sequence
  Variant of sucrose synthase
MIEVLRQQLLDSPRSWRAFLRHLVASQRDMWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2431 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagcgaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2432 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAAKLADFLEAARERPKYWEEISDAALARVSERYTWERYAERLMTIARCFGFWRFVLSRESQVMERYLQMFRHLQWRPLAHAVPME

SEQ ID NO: 2433 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgaccattggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcacatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2434 - protein, 793 aa, Artificial Sequence
  Variant of sucrose synthase
MIEVLRQQLLDSPRSWRAFLRHLVASQRDHWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGHIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2435 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgcttgcagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2436 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRLQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2437 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgaccagtggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2438 - protein, 793 aa, Artificial Sequence
  Variant of sucrose synthase
MIEVLRQQLLDSPRSWRAFLRHLVASQRDQWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2439 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttctgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2440 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVLQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2441 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaacagggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2442 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREQGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2443 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagtgaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2444 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAVKLADFLEAARERPKYWEEISDAALARVSERYTWERYAERLMTIARCFGFWRFVLSRESQVMERYLQMFRHLQWRPLAHAVPME

SEQ ID NO: 2445 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatgggg

SEQ ID NO: 2446 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPMG

SEQ ID NO: 2447 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttgcgcgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2448 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFAREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2449 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtgagcgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2450 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRERLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2451 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgcggtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2452 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSRWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2453 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaggccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2454 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQRPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2455 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttacaggcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2456 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLQAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2457 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgcggatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2458 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMRIARCFGFWRFVLSRESQVMERYLQMFRHLQWRPLAHAVPME

SEQ ID NO: 2459 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagggaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2460 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAGKLADFLEAARERPKYWEEISDAALARVSERYTWERYAERLMTIARCFGFWRFVLSRESQVMERYLQMFRHLQWRPLAHAVPME

SEQ ID NO: 2461 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttatctgcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2462 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLSAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2463 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgaatactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2464 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELNTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2465 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgaagtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2466 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSKWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2467 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatactgatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaactggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2468 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGRETGPDIRGVLEDPQKPIILSMARMDRIKNLSGLAELYGRSARLRSLANLVIIGGHVDVQASMDAEEREEIRRMHEIMDRYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2469 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggctacataccgatttacagcacgcgtgcaagacgtttcgtgaacagcctccggaaggctatcctgaagatattggttggctggcagattttattgcgcattgccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgggacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcggtggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaggcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2470 - protein, 793 aa, Artificial Sequence
  Variant of sucrose synthase
MIEVLRQQLLDSPRSWRAFLRHLVASQRDSWLHTDLQHACKTFREQPPEGYPEDIGWLADFIAHCQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGGLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSVARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME

SEQ ID NO: 2471 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggctacatactgatttacagcacgcgtgcaagacgtttcgtgaacagcctccggaaggctatcctgaagatattggttggctggcagattttgttacgcattgccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgggacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcggtggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaggcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2472 - protein, 793 aa, Artificial Sequence
  Variant of sucrose synthase
MIEVLRQQLLDSPRSWRAFLRHLVASQRDSWLHTDLQHACKTFREQPPEGYPEDIGWLADFVTHCQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGGLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSVARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME

SEQ ID NO: 2473 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggctacatgaagatttacagcacgcgtgcaagacgtttcgtgaacagcctccggaaggctatcctgaagatattggttggctggcagattttgttgcgcattgccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgggacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccatcctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcggtggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2474 - protein, 793 aa, Artificial Sequence
  Variant of sucrose synthase
MIEVLRQQLLDSPRSWRAFLRHLVASQRDSWLHEDLQHACKTFREQPPEGYPEDIGWLADFVAHCQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGGLVATILSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSVARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2475 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggctacatgaagatttacagcacgcgtgcaagacgtttcgtgaacagcctccggaaggctatcctgaagatattggttggctggcagattttgttgcgcatactcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgggacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcggtggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaggcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2476 - protein, 793 aa, Artificial Sequence
  Variant of sucrose synthase
MIEVLRQQLLDSPRSWRAFLRHLVASQRDSWLHEDLQHACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGGLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSVARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME

SEQ ID NO: 2477 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggctacataccgatttacagcacgcgtgcaagacgtttcgtgaacagcctccggaaggctatcctgaagatattggttggctggcagattttattgcgcattgccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccatcctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcggtggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaggcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2478 - protein, 793 aa, Artificial Sequence
  Variant of sucrose synthase
MIEVLRQQLLDSPRSWRAFLRHLVASQRDSWLHTDLQHACKTFREQPPEGYPEDIGWLADFIAHCQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGGLVATILSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSVARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME

SEQ ID NO: 2479 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggctacataccgatttacagcacgcgtgcaagacgtttcgtgaacagcctccggaaggctatcctgaagatattggttggctggcagattttgttgcgcatactcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgggacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccatcctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcggtggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2480 - protein, 793 aa, Artificial Sequence
  Variant of sucrose synthase
MIEVLRQQLLDSPRSWRAFLRHLVASQRDSWLHTDLQHACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGNLVATILSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSVARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2481 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggctacataccgatttacagcacgcgtgcaagacgtttcgtgaacagcctccggaaggctatcctgaagatattggttggctggcagattttgttacgcattgccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccatcctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcggtggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2482 - protein, 793 aa, Artificial Sequence
  Variant of sucrose synthase
MIEVLRQQLLDSPRSWRAFLRHLVASQRDSWLHTDLQHACKTFREQPPEGYPEDIGWLADFVTHCQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGGLVATILSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSVARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2483 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggctacatactgatttacagcacgcgtgcaagacgtttcgtgaacagcctccggaaggctatcctgaagatattggttggctggcagattttgtcgcgcatactcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgggacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccatcctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcggtggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2484 - protein, 793 aa, Artificial Sequence
  Variant of sucrose synthase
MIEVLRQQLLDSPRSWRAFLRHLVASQRDSWLHTDLQHACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGGLVATILSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSVARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2485 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggctacataccgatttacagcacgcgtgcaagacgtttcgtgaacagcctccggaaggctatcctgaagatattggttggctggcagattttattgcgcatactcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgggacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccatcctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcggtggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2486 - protein, 793 aa, Artificial Sequence
  Variant of sucrose synthase
MIEVLRQQLLDSPRSWRAFLRHLVASQRDSWLHTDLQHACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGNLVATILSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSVARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2487 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggctacatactgatttacagcacgcgtgcaagacgtttcgtgaacagcctccggaaggctatcctgaagatattggttggctggcagattttattgcgcatactcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgggacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccatcctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcggtggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2488 - protein, 793 aa, Artificial Sequence
  Variant of sucrose synthase
MIEVLRQQLLDSPRSWRAFLRHLVASQRDSWLHTDLQHACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGGLVATILSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSVARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2489 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggctacatgaagatttacagcacgcgtgcaagacgtttcgtgaacagcctccggaaggctatcctgaagatattggttggctggcagattttgttgcgcatactcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgggacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccatcctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcggtggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2490 - protein, 793 aa, Artificial Sequence
  Variant of sucrose synthase
MIEVLRQQLLDSPRSWRAFLRHLVASQRDSWLHEDLQHACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGGLVATILSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSVARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2491 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggctacatactgatttacagcacgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcatctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2492 - protein, 793 aa, Artificial Sequence
  Variant of sucrose synthase
MIEVLRQQLLDSPRSWRAFLRHLVASQRDSWLHTDLQHACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSHLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2493 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggctacatactgatttacagcacgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgaatctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2494 - protein, 793 aa, Artificial Sequence
  Variant of sucrose synthase
MIEVLRQQLLDSPRSWRAFLRHLVASQRDSWLHTDLQHACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSNLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2495 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggctacatactgatttacagcacgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcggctctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2496 - protein, 793 aa, Artificial Sequence
  Variant of sucrose synthase
MIEVLRQQLLDSPRSWRAFLRHLVASQRDSWLHTDLQHACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSALDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2497 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggctacataccgatttacagcacgcgtgcaagacgtttcgtgaacagcctccggaaggctatcctgaagatattggttggctggcagattttattgcgcattgccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgggacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcggtggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2498 - protein, 793 aa, Artificial Sequence
  Variant of sucrose synthase
MIEVLRQQLLDSPRSWRAFLRHLVASQRDSWLHTDLQHACKTFREQPPEGYPEDIGWLADFIAHCQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGGLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSVARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2499 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggctacatactgatttacagcacgcgtgcaagacgtttcgtgaacagcctccggaaggctatcctgaagatattggttggctggcagattttattgcgcatactcaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgggacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccatcctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcgatggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2500 - protein, 793 aa, Artificial Sequence
  Variant of sucrose synthase
MIEVLRQQLLDSPRSWRAFLRHLVASQRDSWLHTDLQHACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGGLVATILSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSMARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2501 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggctacataccgatttacagcacgcgtgcaagacgtttcgtgaacagcctccggaaggctatcctgaagatattggttggctggcagattttattgcgcattgccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgggacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaacctggttgcaaccatcctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcggtggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2502 - protein, 793 aa, Artificial Sequence
  Variant of sucrose synthase
MIEVLRQQLLDSPRSWRAFLRHLVASQRDSWLHTDLQHACKTFREQPPEGYPEDIGWLADFIAHCQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGNLVATILSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSVARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2503 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggctacatactgatttacagcacgcgtgcaagacgtttcgtgaacagcctccggaaggctatcctgaagatattggttggctggcagattttgttgcgcattgccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgggacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccctgctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcggtggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcagctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2504 - protein, 793 aa, Artificial Sequence
  Variant of sucrose synthase
MIEVLRQQLLDSPRSWRAFLRHLVASQRDSWLHTDLQHACKTFREQPPEGYPEDIGWLADFVAHCQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIGTRLIPESDGTTCDQRLEPVHGAENVQILRVPFRYEDGRIHPHWISRFKVWPYLERYARDLEREVKAELGSRPDLIIGNYSDGGLVATLLSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSVARMDRIKNLSGLAELYGRSARLRSLANLVIIGGHVDVQASMDAEEREEIRRMHEIMDRYQLDGQMRWVGSQLDKRVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2505 - DNA, 2412 bp, Artificial Sequence
  Variant of sucrose synthase
atgcaccatcatcatcatcatggcggtagcggcatgattgaagtactgcgccaacagctgctggatagcccgcgttcatggcgtgcattcctgcgtcatttagtcgcatctcagcgtgactcatggctacataccgatttacagcacgcgtgcaagacgtttcgtgaacagcctccggaaggctatcctgaagatattggttggctggcagattttattgcgcattgccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtgggctggttgcaaccatcctgtcagaaaaattaggtgttacgcagtgcaacattgcacatgccctggagaaaagcaagtacccggggtccgatctgcattggccgctgtatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgagtacgtattttagctatgcccgtcatgaagaacgcttctcgtcgctgtggccagaaatcgaaagtctgctgtttggccgcgaaccaggtccggatattcgtggtgttctcgaagatcctcagaaaccgattattctgtcggtggcccgtatggatcgcatcaagaacctgagcggtctggccgaactgtatggtcggagtgcgcgcttacgtagcctggccaatttggtgatcatcggtggtcatgttgatgtacaggccagtatggatgcagaagaacgcgaagaaatccgtcgtatgcacgagatcatggaccgctaccagctggatggtcagatgcgttgggtgggatcgcatctggataaacgcgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtagcagaaaaactggccgacttcctggaagcagcgcgtgaacgtccgaagtattgggaggaaattagccaggcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2506 - protein, 804 aa, Artificial Sequence
  Variant of sucrose synthase
MHHHHHHGGSGMIEVLRQQLLDSPRSWRAFLRHLVASQRDSWLHTDLQHACKTFREQPPEGYPEDIGWLADFIAHCQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGGLVATILSEKLGVTQCNIAHALEKSKYPGSDLHWPLYEQDHHFACQFTADLIAMNAADIIVTSTYQEIAGNDREVGQYESHQDYTLPGLYRVENGIDVFDSKFNIVSPGADPSTYFSYARHEERFSSLWPEIESLLFGREPGPDIRGVLEDPQKPIILSVARMDRIKNLSGLAELYGRSARLRSLANLVIIGGHVDVQASMDAEEREEIRRMHEIMDRYQLDGQMRWVGSHLDKRVVGELYRVVADGRGVFVQPALFEAFGLTVIEAMSSGLPVFATRHGGPLEIIEDGVSGFHIDPNDPEAVAEKLADFLEAARERPKYWEEISQAALARVSERYTWERYAERLMTIARCFGFWRFVLSRESQVMERYLQMFRHLQWRPLAHAVPME
